United States Patent 11,596,686 (CORONAVIRUS VACCINE) - sequence listing, part 12

SEQ ID NO: 23834 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_Y453F_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23835 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_D614G_I692V)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23836 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_D614G_M1229I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23837 - RNA, 4185 nt, synthetic construct
  misc_feature 1..4185: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23838 - RNA, 4185 nt, synthetic construct
  misc_feature 1..4185: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4185: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23839 - RNA, 4182 nt, synthetic construct
  misc_feature 1..4182: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23840 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23841 - RNA, 4182 nt, synthetic construct
  misc_feature 1..4182: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4182: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23842 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_E484K_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23843 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23844 - RNA, 4191 nt, synthetic construct
  misc_feature 1..4191: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4191: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23845 - RNA, 1459 nt, synthetic construct
  misc_feature 1..1459: note = SARS-CoV-2/Wuhan/WIV05/2019__EPI_ISL_402128 spike protein mRNA gc (1-15,334-528) Ferritin construct
  source 1..1459: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23846 - RNA, 1057 nt, synthetic construct
  misc_feature 1..1057: note = SARS-CoV-2/Wuhan/WIV05/2019__EPI_ISL_402128 spike protein mRNA gc (334-528) Foldon construct
  source 1..1057: mol_type = other RNA
aggagacccgtgacccggaagttgtacggctacgcgactttccctcccacaaaccctcgcgcccttcctttcctacttgggcccggcagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23847 - RNA, 1435 nt, synthetic construct
  misc_feature 1..1435: note = SARS-CoV-2/Wuhan/WIV05/2019__EPI_ISL_402128 spike protein mRNA gc (1-15,334-528) LumSynth construct
  source 1..1435: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23848 - RNA, 1396 nt, synthetic construct
  misc_feature 1..1396: note = SARS-CoV-2/Wuhan/WIV05/2019__EPI_ISL_402128 spike protein mRNA gc (334-528) LumSynth construct
  source 1..1396: mol_type = other RNA
aggagacccgtgacccggaagttgtacggctacgcgactttccctcccacaaaccctcgcgcccttcctttcctacttgggcccggcagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23849 - RNA, 4129 nt, synthetic construct
  misc_feature 1..4129: note = SARS-CoV-2/Wuhan/WIV05/2019__EPI_ISL_402128 spike protein mRNA gc (1-1273)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23850 - RNA, 4129 nt, synthetic construct
  misc_feature 1..4129: note = SARS-CoV-2/Wuhan/WIV05/2019__EPI_ISL_402128 spike protein mRNA gc (1-1273)(D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23851 - RNA, 4129 nt, synthetic construct
  misc_feature 1..4129: note = SARS-CoV-2/Wuhan/WIV05/2019__EPI_ISL_402128 spike protein mRNA gc (1-1273)(A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23852 - RNA, 4129 nt, synthetic construct
  misc_feature 1..4129: note = SARS-CoV-2/Wuhan/WIV05/2019__EPI_ISL_402128 spike protein mRNA gc (1-1273)(N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23853 - RNA, 4129 nt, synthetic construct
  misc_feature 1..4129: note = SARS-CoV-2/Wuhan/WIV05/2019__EPI_ISL_402128 spike protein mRNA gc (1-1273)(S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23854 - RNA, 4129 nt, synthetic construct
  misc_feature 1..4129: note = SARS-CoV-2/Wuhan/WIV05/2019__EPI_ISL_402128 spike protein mRNA gc (1-1273)(N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23855 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23856 - RNA, 4129 nt, synthetic construct
  misc_feature 1..4129: note = SARS-CoV-2/Wuhan/WIV05/2019__EPI_ISL_402128 spike protein mRNA gc (1-1273)(Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23857 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23858 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23859 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23860 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_Y453F_D614G_I692V_M1229I)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23861 - RNA, 4120 nt, synthetic construct
  misc_feature 1..4120: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23862 - RNA, 4129 nt, synthetic construct
  misc_feature 1..4129: note = SARS-CoV-2/Wuhan/WIV05/2019__EPI_ISL_402128 spike protein mRNA gc (1-1273)(K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23863 - RNA, 4120 nt, synthetic construct
  misc_feature 1..4120: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23864 - RNA, 4129 nt, synthetic construct
  misc_feature 1..4129: note = SARS-CoV-2/Wuhan/WIV05/2019__EPI_ISL_402128 spike protein mRNA gc (1-1273)(E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23865 - RNA, 4129 nt, synthetic construct
  misc_feature 1..4129: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23866 - RNA, 4129 nt, synthetic construct
  misc_feature 1..4129: note = SARS-CoV-2/Wuhan/WIV05/2019__EPI_ISL_402128 spike protein mRNA gc (1-1273)(S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23867 - RNA, 4129 nt, synthetic construct; identical to SEQ ID NO: 23849
  misc_feature 1..4129: note = SARS-CoV-2/Wuhan/WIV05/2019__EPI_ISL_402128 spike protein mRNA gc (1-1273)
  source 1..4129: mol_type = other RNA

SEQ ID NO: 23868 - RNA, 4129 nt, synthetic construct
  misc_feature 1..4129: note = SARS-CoV-2/Wuhan/WIV05/2019__EPI_ISL_402128 spike protein mRNA gc (1-1273)(D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23869 - RNA, 4129 nt, synthetic construct
  misc_feature 1..4129: note = SARS-CoV-2/Wuhan/WIV05/2019__EPI_ISL_402128 spike protein mRNA gc (1-1273)(A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23870 - RNA, 4129 nt, synthetic construct
  misc_feature 1..4129: note = SARS-CoV-2/Wuhan/WIV05/2019__EPI_ISL_402128 spike protein mRNA gc (1-1273)(N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23871 - RNA, 4129 nt, synthetic construct
  misc_feature 1..4129: note = SARS-CoV-2/Wuhan/WIV05/2019__EPI_ISL_402128 spike protein mRNA gc (1-1273)(S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23872 - RNA, 4129 nt, synthetic construct
  misc_feature 1..4129: note = SARS-CoV-2/Wuhan/WIV05/2019__EPI_ISL_402128 spike protein mRNA gc (1-1273)(N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23873 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23874 - RNA, 4129 nt, synthetic construct
  misc_feature 1..4129: note = SARS-CoV-2/Wuhan/WIV05/2019__EPI_ISL_402128 spike protein mRNA gc (1-1273)(Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23875 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23876 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23877 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23878 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_Y453F_D614G_I692V_M1229I)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23879 - RNA, 4120 nt, synthetic construct
  misc_feature 1..4120: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23880 - RNA, 4129 nt, synthetic construct
  misc_feature 1..4129: note = SARS-CoV-2/Wuhan/WIV05/2019__EPI_ISL_402128 spike protein mRNA gc (1-1273)(K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23881 - RNA, 4120 nt, synthetic construct
  misc_feature 1..4120: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23882 - RNA, 4129 nt, synthetic construct
  misc_feature 1..4129: note = SARS-CoV-2/Wuhan/WIV05/2019__EPI_ISL_402128 spike protein mRNA gc (1-1273)(E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23883 - RNA, 4129 nt, synthetic construct
  misc_feature 1..4129: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23884 - RNA, 4129 nt, synthetic construct
  misc_feature 1..4129: note = SARS-CoV-2/Wuhan/WIV05/2019__EPI_ISL_402128 spike protein mRNA gc (1-1273)(S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23885 - RNA, 4129 nt, synthetic construct
  misc_feature 1..4129: note = SARS-CoV-2/Wuhan/WIV05/2019__EPI_ISL_402128 spike protein mRNA gc (1-1273)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23886 - RNA, 4129 nt, synthetic construct
  misc_feature 1..4129: note = SARS-CoV-2/Wuhan/WIV05/2019__EPI_ISL_402128 spike protein mRNA gc (1-1273)(D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23887 - RNA, 4129 nt, synthetic construct
  misc_feature 1..4129: note = SARS-CoV-2/Wuhan/WIV05/2019__EPI_ISL_402128 spike protein mRNA gc (1-1273)(A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23888 - RNA, 4129 nt, synthetic construct
  misc_feature 1..4129: note = SARS-CoV-2/Wuhan/WIV05/2019__EPI_ISL_402128 spike protein mRNA gc (1-1273)(N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23889 - RNA, 4129 nt, synthetic construct
  misc_feature 1..4129: note = SARS-CoV-2/Wuhan/WIV05/2019__EPI_ISL_402128 spike protein mRNA gc (1-1273)(S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23890 - RNA, 4129 nt, synthetic construct
  misc_feature 1..4129: note = SARS-CoV-2/Wuhan/WIV05/2019__EPI_ISL_402128 spike protein mRNA gc (1-1273)(N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23891 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23892 - RNA, 4129 nt, synthetic construct
  misc_feature 1..4129: note = SARS-CoV-2/Wuhan/WIV05/2019__EPI_ISL_402128 spike protein mRNA gc (1-1273)(Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23893 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23894 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23895 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23896 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_Y453F_D614G_I692V_M1229I)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23897 - RNA, 4120 nt, synthetic construct
  misc_feature 1..4120: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23898 - RNA, 4129 nt, synthetic construct
  misc_feature 1..4129: note = SARS-CoV-2/Wuhan/WIV05/2019__EPI_ISL_402128 spike protein mRNA gc (1-1273)(K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23899 - RNA, 4120 nt, synthetic construct
  misc_feature 1..4120: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23900 - RNA, 4129 nt, synthetic construct
  misc_feature 1..4129: note = SARS-CoV-2/Wuhan/WIV05/2019__EPI_ISL_402128 spike protein mRNA gc (1-1273)(E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23901 - RNA, 4129 nt, synthetic construct
  misc_feature 1..4129: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23902 - RNA, 4129 nt, synthetic construct
  misc_feature 1..4129: note = SARS-CoV-2/Wuhan/WIV05/2019__EPI_ISL_402128 spike protein mRNA gc (1-1273)(S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23903 - RNA, 4129 nt, synthetic construct
  misc_feature 1..4129: note = SARS-CoV-2/Wuhan/WIV05/2019__EPI_ISL_402128 spike protein mRNA gc (1-1273)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23904 - RNA, 4129 nt, synthetic construct
  misc_feature 1..4129: note = SARS-CoV-2/Wuhan/WIV05/2019__EPI_ISL_402128 spike protein mRNA gc (1-1273)(D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23905 - RNA, 4129 nt, synthetic construct
  misc_feature 1..4129: note = SARS-CoV-2/Wuhan/WIV05/2019__EPI_ISL_402128 spike protein mRNA gc (1-1273)(A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23906 - RNA, 4129 nt, synthetic construct
  misc_feature 1..4129: note = SARS-CoV-2/Wuhan/WIV05/2019__EPI_ISL_402128 spike protein mRNA gc (1-1273)(N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23907 - RNA, 4129 nt, synthetic construct
  misc_feature 1..4129: note = SARS-CoV-2/Wuhan/WIV05/2019__EPI_ISL_402128 spike protein mRNA gc (1-1273)(S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23908 - RNA, 4129 nt, synthetic construct
  misc_feature 1..4129: note = SARS-CoV-2/Wuhan/WIV05/2019__EPI_ISL_402128 spike protein mRNA gc (1-1273)(N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23909 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23910 - RNA, 4129 nt, synthetic construct
  misc_feature 1..4129: note = SARS-CoV-2/Wuhan/WIV05/2019__EPI_ISL_402128 spike protein mRNA gc (1-1273)(Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23911 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23912 - RNA, 4129 nt, synthetic construct
  misc_feature 1..4129: note = SARS-CoV-2/Wuhan/WIV05/2019__EPI_ISL_402128 spike protein mRNA gc (1-1273)(D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23913 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23914 - RNA, 4123 nt, synthetic construct
  misc_feature 1..4123: note = SARS-CoV-2/Wuhan/WIV05/2019__EPI_ISL_402128 spike protein mRNA gc (1-1273)(H69del_V70del_Y453F_D614G_I692V_M1229I)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23915 - RNA, 4120 nt, synthetic construct
  misc_feature 1..4120: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23916 - RNA, 4129 nt, synthetic construct
  misc_feature 1..4129: note = SARS-CoV-2/Wuhan/WIV05/2019__EPI_ISL_402128 spike protein mRNA gc (1-1273)(K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23917 - RNA, 4120 nt, synthetic construct
  misc_feature 1..4120: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23918 - RNA, 4129 nt, synthetic construct
  misc_feature 1..4129: note = SARS-CoV-2/Wuhan/WIV05/2019__EPI_ISL_402128 spike protein mRNA gc (1-1273)(E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23919 - RNA, 4129 nt, synthetic construct
  misc_feature 1..4129: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23920 - RNA, 4129 nt, synthetic construct
  misc_feature 1..4129: note = SARS-CoV-2/Wuhan/WIV05/2019__EPI_ISL_402128 spike protein mRNA gc (1-1273)(S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23921 - RNA, 4129 nt, synthetic construct
  misc_feature 1..4129: note = SARS-CoV-2/Wuhan/WIV05/2019__EPI_ISL_402128 spike protein mRNA gc mod (1-1273)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23922 - RNA, 4129 nt, synthetic construct
  misc_feature 1..4129: note = SARS-CoV-2/Wuhan/WIV05/2019__EPI_ISL_402128 spike protein mRNA gc mod (1-1273)(D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23923 - RNA, 4129 nt, synthetic construct
  misc_feature 1..4129: note = SARS-CoV-2/Wuhan/WIV05/2019__EPI_ISL_402128 spike protein mRNA gc mod (1-1273)(A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23924 - RNA, 4129 nt, synthetic construct
  misc_feature 1..4129: note = SARS-CoV-2/Wuhan/WIV05/2019__EPI_ISL_402128 spike protein mRNA gc mod (1-1273)(N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23925 - RNA, 4129 nt, synthetic construct
  misc_feature 1..4129: note = SARS-CoV-2/Wuhan/WIV05/2019__EPI_ISL_402128 spike protein mRNA gc mod (1-1273)(S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23926 - RNA, 4129 nt, synthetic construct
  misc_feature 1..4129: note = SARS-CoV-2/Wuhan/WIV05/2019__EPI_ISL_402128 spike protein mRNA gc mod (1-1273)(N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23927 - RNA, 4123 nt, synthetic construct
  misc_feature 1..4123: note = SARS-CoV-2/Wuhan/WIV05/2019__EPI_ISL_402128 spike protein mRNA gc mod (1-1273)(H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23928 - RNA, 4129 nt, synthetic construct
  misc_feature 1..4129: note = SARS-CoV-2/Wuhan/WIV05/2019__EPI_ISL_402128 spike protein mRNA gc mod (1-1273)(Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23929 - RNA, 4129 nt, synthetic construct
  misc_feature 1..4129: note = SARS-CoV-2/Wuhan/WIV05/2019__EPI_ISL_402128 spike protein mRNA gc mod (1-1273)(D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23930 - RNA, 4129 nt, synthetic construct
  misc_feature 1..4129: note = SARS-CoV-2/Wuhan/WIV05/2019__EPI_ISL_402128 spike protein mRNA gc mod (1-1273)(D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23931 - RNA, 4123 nt, synthetic construct
  misc_feature 1..4123: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23932 - RNA, 4123 nt, synthetic construct
  misc_feature 1..4123: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23933 - RNA, 4120 nt, synthetic construct
  misc_feature 1..4120: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23934 - RNA, 4129 nt, synthetic construct
  misc_feature 1..4129: note = SARS-CoV-2/Wuhan/WIV05/2019__EPI_ISL_402128 spike protein mRNA gc mod (1-1273)(K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23935 - RNA, 4120 nt, synthetic construct
  misc_feature 1..4120: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23936 - RNA, 4129 nt, synthetic construct
  misc_feature 1..4129: note = SARS-CoV-2/Wuhan/WIV05/2019__EPI_ISL_402128 spike protein mRNA gc mod (1-1273)(E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23937 - RNA, 4129 nt, synthetic construct
  misc_feature 1..4129: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23938 - RNA, 4129 nt, synthetic construct
  misc_feature 1..4129: note = SARS-CoV-2/Wuhan/WIV05/2019__EPI_ISL_402128 spike protein mRNA gc mod (1-1273)(S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23939 - RNA, 4129 nt, synthetic construct
  misc_feature 1..4129: note = SARS-CoV-2/Wuhan/WIV05/2019__EPI_ISL_402128 spike protein mRNA gc mod (1-1273)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23940 - RNA, 4129 nt, synthetic construct
  misc_feature 1..4129: note = SARS-CoV-2/Wuhan/WIV05/2019__EPI_ISL_402128 spike protein mRNA gc mod (1-1273)(D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23941 - RNA, 4129 nt, synthetic construct
  misc_feature 1..4129: note = SARS-CoV-2/Wuhan/WIV05/2019__EPI_ISL_402128 spike protein mRNA gc mod (1-1273)(A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23942 - RNA, 4129 nt, synthetic construct
  misc_feature 1..4129: note = SARS-CoV-2/Wuhan/WIV05/2019__EPI_ISL_402128 spike protein mRNA gc mod (1-1273)(N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23943 - RNA, 4129 nt, synthetic construct
  misc_feature 1..4129: note = SARS-CoV-2/Wuhan/WIV05/2019__EPI_ISL_402128 spike protein mRNA gc mod (1-1273)(S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23944 - RNA, 4129 nt, synthetic construct
  misc_feature 1..4129: note = SARS-CoV-2/Wuhan/WIV05/2019__EPI_ISL_402128 spike protein mRNA gc mod (1-1273)(N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23945 - RNA, 4123 nt, synthetic construct
  misc_feature 1..4123: note = SARS-CoV-2/Wuhan/WIV05/2019__EPI_ISL_402128 spike protein mRNA gc mod (1-1273)(H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23946 - RNA, 4129 nt, synthetic construct
  misc_feature 1..4129: note = SARS-CoV-2/Wuhan/WIV05/2019__EPI_ISL_402128 spike protein mRNA gc mod (1-1273)(Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23947 - RNA, 4129 nt, synthetic construct
  misc_feature 1..4129: note = SARS-CoV-2/Wuhan/WIV05/2019__EPI_ISL_402128 spike protein mRNA gc mod (1-1273)(D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23948 - RNA, 4129 nt, synthetic construct
  misc_feature 1..4129: note = SARS-CoV-2/Wuhan/WIV05/2019__EPI_ISL_402128 spike protein mRNA gc mod (1-1273)(D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23949 - RNA, 4123 nt, synthetic construct
  misc_feature 1..4123: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23950 - RNA, 4123 nt, synthetic construct
  misc_feature 1..4123: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23951 - RNA, 4120 nt, synthetic construct
  misc_feature 1..4120: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23952 - RNA, 4129 nt, synthetic construct
  misc_feature 1..4129: note = SARS-CoV-2/Wuhan/WIV05/2019__EPI_ISL_402128 spike protein mRNA gc mod (1-1273)(K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23953 - RNA, 4120 nt, synthetic construct
  misc_feature 1..4120: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23954 - RNA, 4129 nt, synthetic construct
  misc_feature 1..4129: note = SARS-CoV-2/Wuhan/WIV05/2019__EPI_ISL_402128 spike protein mRNA gc mod (1-1273)(E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23955 - RNA, 4129 nt, synthetic construct
  misc_feature 1..4129: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23956 - RNA, 4129 nt, synthetic construct
  misc_feature 1..4129: note = SARS-CoV-2/Wuhan/WIV05/2019__EPI_ISL_402128 spike protein mRNA gc mod (1-1273)(S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23957 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P) R10155
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23958 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_ D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23959 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23960 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23961 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23962 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23963 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23964 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23965 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23966 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23967 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23968 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23969 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23970 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23971 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23972 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23973 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23974 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23975 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23976 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_ D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23977 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23978 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23979 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23980 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23981 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23982 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23983 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23984 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23985 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23986 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23987 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23988 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23989 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23990 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23991 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23992 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23993 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23994 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_ D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23995 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23996 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23997 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23998 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23999 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24000 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24001 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24002 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24003 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24004 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24005 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24006 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24007 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24008 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24009 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24010 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24011 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24012 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_ D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24013 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24014 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24015 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24016 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24017 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24018 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24019 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24020 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24021 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24022 - RNA, 4123 nt, synthetic construct
  misc_feature 1..4123: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24023 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24024 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24025 - RNA, 4120 nt, synthetic construct
  misc_feature 1..4120: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24026 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24027 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24028 - RNA, 4129 nt, synthetic construct
  misc_feature 1..4129: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24029 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24030 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_ D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24031 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24032 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24033 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24034 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24035 - RNA, 4123 nt, synthetic construct
  misc_feature 1..4123: note = SARS-CoV-2/Wuhan/WIV05/2019__EPI_ISL_402128 spike protein mRNA gc mod (1-1273)(K986P_V987P_H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24036 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24037 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24038 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24039 - RNA, 4123 nt, synthetic construct
  misc_feature 1..4123: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24040 - RNA, 4123 nt, synthetic construct
  misc_feature 1..4123: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4123: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24041 - RNA, 4120 nt, synthetic construct
  misc_feature 1..4120: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24042 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24043 - RNA, 4120 nt, synthetic construct
  misc_feature 1..4120: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24044 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24045 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24046 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24047 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24048 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_ D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24049 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_A222V_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24050 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_N439K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24051 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_S477N_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24052 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24053 - RNA, 4123 nt, synthetic construct
  misc_feature 1..4123: note = SARS-CoV-2/Wuhan/WIV05/2019__EPI_ISL_402128 spike protein mRNA gc mod (1-1273)(K986P_V987P_H69del_V70del_D614G)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24054 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_Y453F_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24055 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_D614G_I692V)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24056 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_D614G_M1229I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24057 - RNA, 4123 nt, synthetic construct
  misc_feature 1..4123: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24058 - RNA, 4123 nt, synthetic construct
  misc_feature 1..4123: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4123: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24059 - RNA, 4120 nt, synthetic construct
  misc_feature 1..4120: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24060 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24061 - RNA, 4120 nt, synthetic construct
  misc_feature 1..4120: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4120: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24062 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_E484K_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24063 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24064 - RNA, 4129 nt, synthetic construct
  misc_feature 1..4129: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4129: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtgtccacctgtccctcctgggctgctggattgtctcgttttcctgccaaataaacaggatcagcgctttacagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24065 - RNA, 1365 nt, synthetic construct
  misc_feature 1..1365: note = SARS-CoV-2/Wuhan/WIV05/2019__EPI_ISL_402128 spike protein mRNA gc (1-15,334-528) Ferritin construct
  source 1..1365: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24066 - RNA, 963 nt, synthetic construct
  misc_feature 1..963: note = SARS-CoV-2/Wuhan/WIV05/2019__EPI_ISL_402128 spike protein mRNA gc (334-528) Foldon construct
  source 1..963: mol_type = other RNA
aggagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24067 - RNA, 1341 nt, synthetic construct
  misc_feature 1..1341: note = SARS-CoV-2/Wuhan/WIV05/2019__EPI_ISL_402128 spike protein mRNA gc (1-15,334-528) LumSynth construct
  source 1..1341: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24068 - RNA, 1302 nt, synthetic construct
  misc_feature 1..1302: note = SARS-CoV-2/Wuhan/WIV05/2019__EPI_ISL_402128 spike protein mRNA gc (334-528) LumSynth construct
  source 1..1302: mol_type = other RNA
aggagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24069 - RNA, 4035 nt, synthetic construct
  misc_feature 1..4035: note = SARS-CoV-2/Wuhan/WIV05/2019__EPI_ISL_402128 spike protein mRNA gc (1-1273)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24070 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24071 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24072 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24073 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24074 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24075 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24076 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24077 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24078 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24079 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24080 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24081 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24082 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24083 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24084 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24085 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24086 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24087 - RNA, 4035 nt, synthetic construct; identical to SEQ ID NO: 24069
  misc_feature 1..4035: note = SARS-CoV-2/Wuhan/WIV05/2019__EPI_ISL_402128 spike protein mRNA gc (1-1273)
  source 1..4035: mol_type = other RNA

SEQ ID NO: 24088 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24089 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24090 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24091 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24092 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24093 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24094 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24095 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24096 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24097 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24098 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24099 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24100 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24101 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24102 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24103 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24104 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24105 - RNA, 4035 nt, synthetic construct
  misc_feature 1..4035: note = SARS-CoV-2/Wuhan/WIV05/2019__EPI_ISL_402128 spike protein mRNA gc (1-1273)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24106 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24107 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24108 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24109 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24110 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24111 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24112 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24113 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24114 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24115 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24116 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24117 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24118 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24119 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24120 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24121 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24122 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24123 - RNA, 4035 nt, synthetic construct
  misc_feature 1..4035: note = SARS-CoV-2/Wuhan/WIV05/2019__EPI_ISL_402128 spike protein mRNA gc (1-1273)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24124 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24125 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24126 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24127 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24128 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24129 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24130 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24131 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24132 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24133 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24134 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24135 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24136 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24137 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24138 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24139 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24140 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24141 - RNA, 4035 nt, synthetic construct
  misc_feature 1..4035: note = SARS-CoV-2/Wuhan/WIV05/2019__EPI_ISL_402128 spike protein mRNA gc mod (1-1273)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24142 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24143 - RNA, 4035 nt, synthetic construct
  misc_feature 1..4035: note = SARS-CoV-2/Wuhan/WIV05/2019__EPI_ISL_402128 spike protein mRNA gc mod (1-1273)(A222V_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24144 - RNA, 4035 nt, synthetic construct
  misc_feature 1..4035: note = SARS-CoV-2/Wuhan/WIV05/2019__EPI_ISL_402128 spike protein mRNA gc mod (1-1273)(N439K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24145 - RNA, 4035 nt, synthetic construct
  misc_feature 1..4035: note = SARS-CoV-2/Wuhan/WIV05/2019__EPI_ISL_402128 spike protein mRNA gc mod (1-1273)(S477N_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24146 - RNA, 4035 nt, synthetic construct
  misc_feature 1..4035: note = SARS-CoV-2/Wuhan/WIV05/2019__EPI_ISL_402128 spike protein mRNA gc mod (1-1273)(N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24147 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_D614G)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24148 - RNA, 4035 nt, synthetic construct
  misc_feature 1..4035: note = SARS-CoV-2/Wuhan/WIV05/2019__EPI_ISL_402128 spike protein mRNA gc mod (1-1273)(Y453F_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24149 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_I692V)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24150 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_M1229I)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24151 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24152 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24153 - RNA, 4026 nt, synthetic construct
  misc_feature 1..4026: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4026: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24154 - RNA, 4035 nt, synthetic construct
  misc_feature 1..4035: note = SARS-CoV-2/Wuhan/WIV05/2019__EPI_ISL_402128 spike protein mRNA gc mod (1-1273)(K417N_E484K_N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24155 - RNA, 4026 nt, synthetic construct
  misc_feature 1..4026: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24156 - RNA, 4035 nt, synthetic construct
  misc_feature 1..4035: note = SARS-CoV-2/Wuhan/WIV05/2019__EPI_ISL_402128 spike protein mRNA gc mod (1-1273)(E484K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24157 - RNA, 4035 nt, synthetic construct
  misc_feature 1..4035: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24158 - RNA, 4035 nt, synthetic construct
  misc_feature 1..4035: note = SARS-CoV-2/Wuhan/WIV05/2019__EPI_ISL_402128 spike protein mRNA gc mod (1-1273)(S13I_W152C_L452R_D614G)
  source 1..4035: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24159 - RNA, 4035 nt, synthetic construct
  misc_feature 1..4035: note = SARS-CoV-2/Wuhan/WIV05/2019__EPI_ISL_402128 spike protein mRNA gc mod (1-1273)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24160 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24161 - RNA, 4035 nt, synthetic construct
  misc_feature 1..4035: note = SARS-CoV-2/Wuhan/WIV05/2019__EPI_ISL_402128 spike protein mRNA gc mod (1-1273)(A222V_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24162 - RNA, 4035 nt, synthetic construct
  misc_feature 1..4035: note = SARS-CoV-2/Wuhan/WIV05/2019__EPI_ISL_402128 spike protein mRNA gc mod (1-1273)(N439K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24163 - RNA, 4035 nt, synthetic construct
  misc_feature 1..4035: note = SARS-CoV-2/Wuhan/WIV05/2019__EPI_ISL_402128 spike protein mRNA gc mod (1-1273)(S477N_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24164 - RNA, 4035 nt, synthetic construct
  misc_feature 1..4035: note = SARS-CoV-2/Wuhan/WIV05/2019__EPI_ISL_402128 spike protein mRNA gc mod (1-1273)(N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24165 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_D614G)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24166 - RNA, 4035 nt, synthetic construct
  misc_feature 1..4035: note = SARS-CoV-2/Wuhan/WIV05/2019__EPI_ISL_402128 spike protein mRNA gc mod (1-1273)(Y453F_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24167 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_I692V)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24168 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_M1229I)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24169 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24170 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24171 - RNA, 4026 nt, synthetic construct
  misc_feature 1..4026: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24172 - RNA, 4035 nt, synthetic construct
  misc_feature 1..4035: note = SARS-CoV-2/Wuhan/WIV05/2019__EPI_ISL_402128 spike protein mRNA gc mod (1-1273)(K417N_E484K_N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24173 - RNA, 4026 nt, synthetic construct
  misc_feature 1..4026: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24174 - RNA, 4035 nt, synthetic construct
  misc_feature 1..4035: note = SARS-CoV-2/Wuhan/WIV05/2019__EPI_ISL_402128 spike protein mRNA gc mod (1-1273)(E484K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24175 - RNA, 4035 nt, synthetic construct
  misc_feature 1..4035: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24176 - RNA, 4035 nt, synthetic construct
  misc_feature 1..4035: note = SARS-CoV-2/Wuhan/WIV05/2019__EPI_ISL_402128 spike protein mRNA gc mod (1-1273)(S13I_W152C_L452R_D614G)
  source 1..4035: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24177 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24178 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24179 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24180 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24181 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24182 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24183 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24184 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24185 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24186 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24187 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24188 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24189 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24190 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24191 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24192 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24193 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24194 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24195 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24196 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24197 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24198 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24199 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24200 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24201 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24202 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24203 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24204 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24205 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24206 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24207 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24208 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24209 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24210 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24211 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24212 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24213 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24214 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24215 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24216 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24217 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24218 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24219 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24220 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24221 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24222 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24223 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24224 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24225 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24226 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24227 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24228 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24229 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24230 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24231 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24232 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24233 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24234 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24235 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24236 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24237 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24238 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24239 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24240 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24241 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24242 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24243 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24244 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24245 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24246 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24247 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24248 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24249 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24250 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_ D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24251 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_A222V_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24252 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N439K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24253 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_S477N_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24254 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24255 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_D614G)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24256 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_Y453F_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24257 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_I692V)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24258 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_M1229I)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24259 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24260 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24261 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24262 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24263 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24264 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_E484K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24265 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24266 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4035: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24267 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24268 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_ D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24269 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_A222V_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24270 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N439K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24271 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_S477N_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24272 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24273 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_D614G)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24274 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_Y453F_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24275 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_I692V)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24276 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_M1229I)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24277 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24278 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24279 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24280 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24281 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24282 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_E484K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24283 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24284 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4035: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24285 - RNA, 1371 nt, synthetic construct
  misc_feature 1..1371: note = SARS-CoV-2/Wuhan/WIV05/2019__EPI_ISL_402128 spike protein mRNA gc (1-15,334-528) Ferritin construct
  source 1..1371: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24286 - RNA, 969 nt, synthetic construct
  misc_feature 1..969: note = SARS-CoV-2/Wuhan/WIV05/2019__EPI_ISL_402128 spike protein mRNA gc (334-528) Foldon construct
  source 1..969: mol_type = other RNA
aggagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24287 - RNA, 1347 nt, synthetic construct
  misc_feature 1..1347: note = SARS-CoV-2/Wuhan/WIV05/2019__EPI_ISL_402128 spike protein mRNA gc (1-15,334-528) LumSynth construct
  source 1..1347: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24288 - RNA, 1308 nt, synthetic construct
  misc_feature 1..1308: note = SARS-CoV-2/Wuhan/WIV05/2019__EPI_ISL_402128 spike protein mRNA gc (334-528) LumSynth construct
  source 1..1308: mol_type = other RNA
aggagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24289 - RNA, 4041 nt, synthetic construct
  misc_feature 1..4041: note = SARS-CoV-2/Wuhan/WIV05/2019__EPI_ISL_402128 spike protein mRNA gc (1-1273)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24290 - RNA, 4041 nt, synthetic construct
  misc_feature 1..4041: note = SARS-CoV-2/Wuhan/WIV05/2019__EPI_ISL_402128 spike protein mRNA gc (1-1273)(D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24291 - RNA, 4041 nt, synthetic construct
  misc_feature 1..4041: note = SARS-CoV-2/Wuhan/WIV05/2019__EPI_ISL_402128 spike protein mRNA gc (1-1273)(A222V_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24292 - RNA, 4041 nt, synthetic construct
  misc_feature 1..4041: note = SARS-CoV-2/Wuhan/WIV05/2019__EPI_ISL_402128 spike protein mRNA gc (1-1273)(N439K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24293 - RNA, 4041 nt, synthetic construct
  misc_feature 1..4041: note = SARS-CoV-2/Wuhan/WIV05/2019__EPI_ISL_402128 spike protein mRNA gc (1-1273)(S477N_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24294 - RNA, 4041 nt, synthetic construct
  misc_feature 1..4041: note = SARS-CoV-2/Wuhan/WIV05/2019__EPI_ISL_402128 spike protein mRNA gc (1-1273)(N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24295 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24296 - RNA, 4041 nt, synthetic construct
  misc_feature 1..4041: note = SARS-CoV-2/Wuhan/WIV05/2019__EPI_ISL_402128 spike protein mRNA gc (1-1273)(Y453F_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24297 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_I692V)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24298 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_M1229I)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24299 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24300 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_Y453F_D614G_I692V_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24301 - RNA, 4032 nt, synthetic construct
  misc_feature 1..4032: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4032: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24302 - RNA, 4041 nt, synthetic construct
  misc_feature 1..4041: note = SARS-CoV-2/Wuhan/WIV05/2019__EPI_ISL_402128 spike protein mRNA gc (1-1273)(K417N_E484K_N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24303 - RNA, 4032 nt, synthetic construct
  misc_feature 1..4032: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4032: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24304 - RNA, 4041 nt, synthetic construct
  misc_feature 1..4041: note = SARS-CoV-2/Wuhan/WIV05/2019__EPI_ISL_402128 spike protein mRNA gc (1-1273)(E484K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24305 - RNA, 4041 nt, synthetic construct
  misc_feature 1..4041: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4041: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24306 - RNA, 4041 nt, synthetic construct
  misc_feature 1..4041: note = SARS-CoV-2/Wuhan/WIV05/2019__EPI_ISL_402128 spike protein mRNA gc (1-1273)(S13I_W152C_L452R_D614G)
  source 1..4041: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24307 - RNA, 4041 nt, synthetic construct; identical to SEQ ID NO: 24289
  misc_feature 1..4041: note = SARS-CoV-2/Wuhan/WIV05/2019__EPI_ISL_402128 spike protein mRNA gc (1-1273)
  source 1..4041: mol_type = other RNA

SEQ ID NO: 24308 - RNA, 4041 nt, synthetic construct
  misc_feature 1..4041: note = SARS-CoV-2/Wuhan/WIV05/2019__EPI_ISL_402128 spike protein mRNA gc (1-1273)(D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24309 - RNA, 4041 nt, synthetic construct
  misc_feature 1..4041: note = SARS-CoV-2/Wuhan/WIV05/2019__EPI_ISL_402128 spike protein mRNA gc (1-1273)(A222V_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24310 - RNA, 4041 nt, synthetic construct
  misc_feature 1..4041: note = SARS-CoV-2/Wuhan/WIV05/2019__EPI_ISL_402128 spike protein mRNA gc (1-1273)(N439K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24311 - RNA, 4041 nt, synthetic construct
  misc_feature 1..4041: note = SARS-CoV-2/Wuhan/WIV05/2019__EPI_ISL_402128 spike protein mRNA gc (1-1273)(S477N_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24312 - RNA, 4041 nt, synthetic construct
  misc_feature 1..4041: note = SARS-CoV-2/Wuhan/WIV05/2019__EPI_ISL_402128 spike protein mRNA gc (1-1273)(N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24313 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24314 - RNA, 4041 nt, synthetic construct
  misc_feature 1..4041: note = SARS-CoV-2/Wuhan/WIV05/2019__EPI_ISL_402128 spike protein mRNA gc (1-1273)(Y453F_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24315 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_I692V)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24316 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_M1229I)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24317 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24318 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_Y453F_D614G_I692V_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24319 - RNA, 4032 nt, synthetic construct
  misc_feature 1..4032: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4032: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24320 - RNA, 4041 nt, synthetic construct
  misc_feature 1..4041: note = SARS-CoV-2/Wuhan/WIV05/2019__EPI_ISL_402128 spike protein mRNA gc (1-1273)(K417N_E484K_N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24321 - RNA, 4032 nt, synthetic construct
  misc_feature 1..4032: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4032: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24322 - RNA, 4041 nt, synthetic construct
  misc_feature 1..4041: note = SARS-CoV-2/Wuhan/WIV05/2019__EPI_ISL_402128 spike protein mRNA gc (1-1273)(E484K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24323 - RNA, 4041 nt, synthetic construct
  misc_feature 1..4041: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4041: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24324 - RNA, 4041 nt, synthetic construct
  misc_feature 1..4041: note = SARS-CoV-2/Wuhan/WIV05/2019__EPI_ISL_402128 spike protein mRNA gc (1-1273)(S13I_W152C_L452R_D614G)
  source 1..4041: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24325 - RNA, 4041 nt, synthetic construct
  misc_feature 1..4041: note = SARS-CoV-2/Wuhan/WIV05/2019__EPI_ISL_402128 spike protein mRNA gc (1-1273)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24326 - RNA, 4041 nt, synthetic construct
  misc_feature 1..4041: note = SARS-CoV-2/Wuhan/WIV05/2019__EPI_ISL_402128 spike protein mRNA gc (1-1273)(D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24327 - RNA, 4041 nt, synthetic construct
  misc_feature 1..4041: note = SARS-CoV-2/Wuhan/WIV05/2019__EPI_ISL_402128 spike protein mRNA gc (1-1273)(A222V_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24328 - RNA, 4041 nt, synthetic construct
  misc_feature 1..4041: note = SARS-CoV-2/Wuhan/WIV05/2019__EPI_ISL_402128 spike protein mRNA gc (1-1273)(N439K_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24329 - RNA, 4041 nt, synthetic construct
  misc_feature 1..4041: note = SARS-CoV-2/Wuhan/WIV05/2019__EPI_ISL_402128 spike protein mRNA gc (1-1273)(S477N_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24330 - RNA, 4041 nt, synthetic construct
  misc_feature 1..4041: note = SARS-CoV-2/Wuhan/WIV05/2019__EPI_ISL_402128 spike protein mRNA gc (1-1273)(N501Y_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24331 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24332 - RNA, 4041 nt, synthetic construct
  misc_feature 1..4041: note = SARS-CoV-2/Wuhan/WIV05/2019__EPI_ISL_402128 spike protein mRNA gc (1-1273)(Y453F_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24333 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_I692V)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24334 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_M1229I)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24335 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24336 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_Y453F_D614G_I692V_M1229I)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24337 - RNA, 4032 nt, synthetic construct
  misc_feature 1..4032: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4032: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24338 - RNA, 4041 nt, synthetic construct
  misc_feature 1..4041: note = SARS-CoV-2/Wuhan/WIV05/2019__EPI_ISL_402128 spike protein mRNA gc (1-1273)(K417N_E484K_N501Y_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24339 - RNA, 4032 nt, synthetic construct
  misc_feature 1..4032: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4032: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24340 - RNA, 4041 nt, synthetic construct
  misc_feature 1..4041: note = SARS-CoV-2/Wuhan/WIV05/2019__EPI_ISL_402128 spike protein mRNA gc (1-1273)(E484K_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24341 - RNA, 4041 nt, synthetic construct
  misc_feature 1..4041: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4041: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24342 - RNA, 4041 nt, synthetic construct
  misc_feature 1..4041: note = SARS-CoV-2/Wuhan/WIV05/2019__EPI_ISL_402128 spike protein mRNA gc (1-1273)(S13I_W152C_L452R_D614G)
  source 1..4041: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24343 - RNA, 4041 nt, synthetic construct
  misc_feature 1..4041: note = SARS-CoV-2/Wuhan/WIV05/2019__EPI_ISL_402128 spike protein mRNA gc (1-1273)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24344 - RNA, 4041 nt, synthetic construct
  misc_feature 1..4041: note = SARS-CoV-2/Wuhan/WIV05/2019__EPI_ISL_402128 spike protein mRNA gc (1-1273)(D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24345 - RNA, 4041 nt, synthetic construct
  misc_feature 1..4041: note = SARS-CoV-2/Wuhan/WIV05/2019__EPI_ISL_402128 spike protein mRNA gc (1-1273)(A222V_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24346 - RNA, 4041 nt, synthetic construct
  misc_feature 1..4041: note = SARS-CoV-2/Wuhan/WIV05/2019__EPI_ISL_402128 spike protein mRNA gc (1-1273)(N439K_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24347 - RNA, 4041 nt, synthetic construct
  misc_feature 1..4041: note = SARS-CoV-2/Wuhan/WIV05/2019__EPI_ISL_402128 spike protein mRNA gc (1-1273)(S477N_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24348 - RNA, 4041 nt, synthetic construct
  misc_feature 1..4041: note = SARS-CoV-2/Wuhan/WIV05/2019__EPI_ISL_402128 spike protein mRNA gc (1-1273)(N501Y_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24349 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24350 - RNA, 4041 nt, synthetic construct
  misc_feature 1..4041: note = SARS-CoV-2/Wuhan/WIV05/2019__EPI_ISL_402128 spike protein mRNA gc (1-1273)(Y453F_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24351 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_I692V)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24352 - RNA, 4041 nt, synthetic construct
  misc_feature 1..4041: note = SARS-CoV-2/Wuhan/WIV05/2019__EPI_ISL_402128 spike protein mRNA gc (1-1273)(D614G_M1229I)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24353 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24354 - RNA, 4035 nt, synthetic construct
  misc_feature 1..4035: note = SARS-CoV-2/Wuhan/WIV05/2019__EPI_ISL_402128 spike protein mRNA gc (1-1273)(H69del_V70del_Y453F_D614G_I692V_M1229I)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24355 - RNA, 4032 nt, synthetic construct
  misc_feature 1..4032: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4032: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24356 - RNA, 4041 nt, synthetic construct
  misc_feature 1..4041: note = SARS-CoV-2/Wuhan/WIV05/2019__EPI_ISL_402128 spike protein mRNA gc (1-1273)(K417N_E484K_N501Y_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24357 - RNA, 4032 nt, synthetic construct
  misc_feature 1..4032: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4032: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24358 - RNA, 4041 nt, synthetic construct
  misc_feature 1..4041: note = SARS-CoV-2/Wuhan/WIV05/2019__EPI_ISL_402128 spike protein mRNA gc (1-1273)(E484K_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24359 - RNA, 4041 nt, synthetic construct
  misc_feature 1..4041: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4041: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24360 - RNA, 4041 nt, synthetic construct
  misc_feature 1..4041: note = SARS-CoV-2/Wuhan/WIV05/2019__EPI_ISL_402128 spike protein mRNA gc (1-1273)(S13I_W152C_L452R_D614G)
  source 1..4041: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24361 - RNA, 4041 nt, synthetic construct
  misc_feature 1..4041: note = SARS-CoV-2/Wuhan/WIV05/2019__EPI_ISL_402128 spike protein mRNA gc mod (1-1273)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24362 - RNA, 4041 nt, synthetic construct
  misc_feature 1..4041: note = SARS-CoV-2/Wuhan/WIV05/2019__EPI_ISL_402128 spike protein mRNA gc mod (1-1273)(D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24363 - RNA, 4041 nt, synthetic construct
  misc_feature 1..4041: note = SARS-CoV-2/Wuhan/WIV05/2019__EPI_ISL_402128 spike protein mRNA gc mod (1-1273)(A222V_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24364 - RNA, 4041 nt, synthetic construct
  misc_feature 1..4041: note = SARS-CoV-2/Wuhan/WIV05/2019__EPI_ISL_402128 spike protein mRNA gc mod (1-1273)(N439K_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24365 - RNA, 4041 nt, synthetic construct
  misc_feature 1..4041: note = SARS-CoV-2/Wuhan/WIV05/2019__EPI_ISL_402128 spike protein mRNA gc mod (1-1273)(S477N_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24366 - RNA, 4041 nt, synthetic construct
  misc_feature 1..4041: note = SARS-CoV-2/Wuhan/WIV05/2019__EPI_ISL_402128 spike protein mRNA gc mod (1-1273)(N501Y_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24367 - RNA, 4035 nt, synthetic construct
  misc_feature 1..4035: note = SARS-CoV-2/Wuhan/WIV05/2019__EPI_ISL_402128 spike protein mRNA gc mod (1-1273)(H69del_V70del_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24368 - RNA, 4041 nt, synthetic construct
  misc_feature 1..4041: note = SARS-CoV-2/Wuhan/WIV05/2019__EPI_ISL_402128 spike protein mRNA gc mod (1-1273)(Y453F_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24369 - RNA, 4041 nt, synthetic construct
  misc_feature 1..4041: note = SARS-CoV-2/Wuhan/WIV05/2019__EPI_ISL_402128 spike protein mRNA gc mod (1-1273)(D614G_I692V)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24370 - RNA, 4041 nt, synthetic construct
  misc_feature 1..4041: note = SARS-CoV-2/Wuhan/WIV05/2019__EPI_ISL_402128 spike protein mRNA gc mod (1-1273)(D614G_M1229I)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24371 - RNA, 4035 nt, synthetic construct
  misc_feature 1..4035: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24372 - RNA, 4035 nt, synthetic construct
  misc_feature 1..4035: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24373 - RNA, 4032 nt, synthetic construct
  misc_feature 1..4032: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4032: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24374 - RNA, 4041 nt, synthetic construct
  misc_feature 1..4041: note = SARS-CoV-2/Wuhan/WIV05/2019__EPI_ISL_402128 spike protein mRNA gc mod (1-1273)(K417N_E484K_N501Y_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24375 - RNA, 4032 nt, synthetic construct
  misc_feature 1..4032: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4032: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24376 - RNA, 4041 nt, synthetic construct
  misc_feature 1..4041: note = SARS-CoV-2/Wuhan/WIV05/2019__EPI_ISL_402128 spike protein mRNA gc mod (1-1273)(E484K_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24377 - RNA, 4041 nt, synthetic construct
  misc_feature 1..4041: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4041: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24378 - RNA, 4041 nt, synthetic construct
  misc_feature 1..4041: note = SARS-CoV-2/Wuhan/WIV05/2019__EPI_ISL_402128 spike protein mRNA gc mod (1-1273)(S13I_W152C_L452R_D614G)
  source 1..4041: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24379 - RNA, 4041 nt, synthetic construct
  misc_feature 1..4041: note = SARS-CoV-2/Wuhan/WIV05/2019__EPI_ISL_402128 spike protein mRNA gc mod (1-1273)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24380 - RNA, 4041 nt, synthetic construct
  misc_feature 1..4041: note = SARS-CoV-2/Wuhan/WIV05/2019__EPI_ISL_402128 spike protein mRNA gc mod (1-1273)(D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24381 - RNA, 4041 nt, synthetic construct
  misc_feature 1..4041: note = SARS-CoV-2/Wuhan/WIV05/2019__EPI_ISL_402128 spike protein mRNA gc mod (1-1273)(A222V_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24382 - RNA, 4041 nt, synthetic construct
  misc_feature 1..4041: note = SARS-CoV-2/Wuhan/WIV05/2019__EPI_ISL_402128 spike protein mRNA gc mod (1-1273)(N439K_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24383 - RNA, 4041 nt, synthetic construct
  misc_feature 1..4041: note = SARS-CoV-2/Wuhan/WIV05/2019__EPI_ISL_402128 spike protein mRNA gc mod (1-1273)(S477N_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24384 - RNA, 4041 nt, synthetic construct
  misc_feature 1..4041: note = SARS-CoV-2/Wuhan/WIV05/2019__EPI_ISL_402128 spike protein mRNA gc mod (1-1273)(N501Y_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24385 - RNA, 4035 nt, synthetic construct
  misc_feature 1..4035: note = SARS-CoV-2/Wuhan/WIV05/2019__EPI_ISL_402128 spike protein mRNA gc mod (1-1273)(H69del_V70del_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24386 - RNA, 4041 nt, synthetic construct
  misc_feature 1..4041: note = SARS-CoV-2/Wuhan/WIV05/2019__EPI_ISL_402128 spike protein mRNA gc mod (1-1273)(Y453F_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24387 - RNA, 4041 nt, synthetic construct
  misc_feature 1..4041: note = SARS-CoV-2/Wuhan/WIV05/2019__EPI_ISL_402128 spike protein mRNA gc mod (1-1273)(D614G_I692V)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24388 - RNA, 4041 nt, synthetic construct
  misc_feature 1..4041: note = SARS-CoV-2/Wuhan/WIV05/2019__EPI_ISL_402128 spike protein mRNA gc mod (1-1273)(D614G_M1229I)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24389 - RNA, 4035 nt, synthetic construct
  misc_feature 1..4035: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24390 - RNA, 4035 nt, synthetic construct
  misc_feature 1..4035: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24391 - RNA, 4032 nt, synthetic construct
  misc_feature 1..4032: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4032: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24392 - RNA, 4041 nt, synthetic construct
  misc_feature 1..4041: note = SARS-CoV-2/Wuhan/WIV05/2019__EPI_ISL_402128 spike protein mRNA gc mod (1-1273)(K417N_E484K_N501Y_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24393 - RNA, 4032 nt, synthetic construct
  misc_feature 1..4032: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4032: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24394 - RNA, 4041 nt, synthetic construct
  misc_feature 1..4041: note = SARS-CoV-2/Wuhan/WIV05/2019__EPI_ISL_402128 spike protein mRNA gc mod (1-1273)(E484K_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24395 - RNA, 4041 nt, synthetic construct
  misc_feature 1..4041: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4041: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24396 - RNA, 4041 nt, synthetic construct
  misc_feature 1..4041: note = SARS-CoV-2/Wuhan/WIV05/2019__EPI_ISL_402128 spike protein mRNA gc mod (1-1273)(S13I_W152C_L452R_D614G)
  source 1..4041: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24397 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P) R10136, R10158
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24398 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_ D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24399 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_A222V_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24400 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N439K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24401 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_S477N_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24402 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24403 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24404 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_Y453F_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24405 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_I692V)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24406 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_M1229I)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24407 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24408 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24409 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4032: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24410 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24411 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4032: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24412 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_E484K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24413 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4041: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24414 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4041: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24415 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24416 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_ D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24417 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_A222V_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24418 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N439K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24419 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_S477N_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24420 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24421 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24422 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_Y453F_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24423 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_I692V)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24424 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_M1229I)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24425 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24426 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24427 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4032: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24428 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24429 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4032: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24430 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_E484K_D614G)
  source 1..4041: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24431 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4041: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24432 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4041: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24433 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24434 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_ D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24435 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_A222V_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24436 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N439K_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24437 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_S477N_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24438 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N501Y_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24439 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24440 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_Y453F_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24441 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_I692V)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24442 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_M1229I)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24443 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24444 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24445 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4032: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24446 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24447 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4032: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24448 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_E484K_D614G)
  source 1..4041: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24449 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4041: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24450 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4041: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24451 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24452 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_ D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24453 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_A222V_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24454 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N439K_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24455 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_S477N_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24456 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_N501Y_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24457 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24458 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_Y453F_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24459 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_I692V)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24460 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_D614G_M1229I)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24461 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24462 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24463 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4032: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24464 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24465 - RNA, 4032 nt, synthetic construct
  misc_feature 1..4032: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4032: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24466 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_E484K_D614G)
  source 1..4041: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24467 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4041: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24468 - RNA, 4041 nt, synthetic construct
  misc_feature 1..4041: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4041: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24469 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24470 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_ D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24471 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_A222V_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24472 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_N439K_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24473 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_S477N_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24474 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_N501Y_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24475 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_H69del_V70del_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24476 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_Y453F_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24477 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_D614G_I692V)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24478 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_D614G_M1229I)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24479 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24480 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24481 - RNA, 4032 nt, synthetic construct
  misc_feature 1..4032: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4032: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24482 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24483 - RNA, 4032 nt, synthetic construct
  misc_feature 1..4032: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4032: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24484 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_E484K_D614G)
  source 1..4041: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24485 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4041: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24486 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4041: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24487 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24488 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_ D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24489 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_A222V_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24490 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_N439K_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24491 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_S477N_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24492 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_N501Y_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24493 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_H69del_V70del_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24494 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_Y453F_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24495 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_D614G_I692V)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24496 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_D614G_M1229I)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24497 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24498 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24499 - RNA, 4032 nt, synthetic construct
  misc_feature 1..4032: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4032: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24500 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24501 - RNA, 4032 nt, synthetic construct
  misc_feature 1..4032: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4032: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24502 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_E484K_D614G)
  source 1..4041: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24503 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4041: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24504 - RNA, 4041 nt, synthetic construct
  misc_feature 1..4041: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4041: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagattaatagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24505 - RNA, 1365 nt, synthetic construct
  misc_feature 1..1365: note = SARS-CoV-2/Wuhan/WIV05/2019__EPI_ISL_402128 spike protein mRNA gc (1-15,334-528) Ferritin construct
  source 1..1365: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24506 - RNA, 963 nt, synthetic construct
  misc_feature 1..963: note = SARS-CoV-2/Wuhan/WIV05/2019__EPI_ISL_402128 spike protein mRNA gc (334-528) Foldon construct
  source 1..963: mol_type = other RNA
aggagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24507 - RNA, 1341 nt, synthetic construct
  misc_feature 1..1341: note = SARS-CoV-2/Wuhan/WIV05/2019__EPI_ISL_402128 spike protein mRNA gc (1-15,334-528) LumSynth construct
  source 1..1341: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24508 - RNA, 1302 nt, synthetic construct
  misc_feature 1..1302: note = SARS-CoV-2/Wuhan/WIV05/2019__EPI_ISL_402128 spike protein mRNA gc (334-528) LumSynth construct
  source 1..1302: mol_type = other RNA
aggagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24509 - RNA, 4035 nt, synthetic construct
  misc_feature 1..4035: note = SARS-CoV-2/Wuhan/WIV05/2019__EPI_ISL_402128 spike protein mRNA gc (1-1273)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24510 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24511 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24512 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24513 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24514 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24515 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24516 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24517 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24518 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24519 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24520 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24521 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24522 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24523 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24524 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24525 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24526 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24527 - RNA, 4035 nt, synthetic construct; identical to SEQ ID NO: 24509
  misc_feature 1..4035: note = SARS-CoV-2/Wuhan/WIV05/2019__EPI_ISL_402128 spike protein mRNA gc (1-1273)
  source 1..4035: mol_type = other RNA

SEQ ID NO: 24528 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24529 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
